United States Patent 12,270,029 (CFTR-MODULATING COMPOSITIONS AND METHODS) - sequence listing, part 2

SEQ ID NO: 620 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 621 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 622 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 623 - protein, 2168 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 624 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 625 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 626 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 627 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 628 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 629 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 630 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 631 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 632 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 633 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 634 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 635 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 636 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 637 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 638 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 639 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 640 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 641 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 642 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 643 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 644 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 645 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 646 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 647 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 648 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 649 - protein, 2190 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 650 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 651 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 652 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 653 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 654 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 655 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 656 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 657 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 658 - protein, 2168 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 659 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 660 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 661 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 662 - protein, 2183 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 663 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 664 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 665 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 666 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 667 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 668 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 669 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 670 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 671 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 672 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 673 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 674 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 675 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 676 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 677 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 678 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 679 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 680 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 681 - protein, 2175 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 682 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 683 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 684 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 685 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 686 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 687 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 688 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 689 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 690 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 691 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 692 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 693 - protein, 2170 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 694 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 695 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 696 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 697 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 698 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 699 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 700 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 701 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 702 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 703 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 704 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 705 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 706 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 707 - protein, 2168 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 708 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 709 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 710 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 711 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 712 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 713 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 714 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 715 - protein, 2208 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 716 - protein, 2192 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 717 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 718 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 719 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 720 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 721 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 722 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 723 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 724 - protein, 2170 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 725 - protein, 2165 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 726 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 727 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 728 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 729 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 730 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 731 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 732 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 733 - protein, 2167 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 734 - protein, 2165 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 735 - protein, 2167 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 736 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 737 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 738 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 739 - protein, 2175 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 740 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 741 - protein, 2012 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGPRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKGDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISDAGKRTADGSEFEKRTADGSEFESPKKKAKVE

SEQ ID NO: 742 - protein, 2012 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGPRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISDAGKRTADGSEFEKRTADGSEFESPKKKAKVE

SEQ ID NO: 743 - protein, 2021 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGPRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAPPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISDAGKRTADGSEFEKRTADGSEFESPKKKAKVE

SEQ ID NO: 744 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGPRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAPPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISDAGKRTADGSEFEKRTADGSEFESPKKKAKVE

SEQ ID NO: 745 - protein, 2032 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 746 - protein, 2045 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 747 - protein, 2029 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 748 - protein, 2024 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 749 - protein, 2012 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 750 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 751 - protein, 2014 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 752 - protein, 2015 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 753 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 754 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 755 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 756 - protein, 2005 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 757 - protein, 2014 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAPPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 758 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGLATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAPPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTTAGKRTADGSEFEKRTADGSEFESPKKKAKVE

SEQ ID NO: 759 - protein, 2072 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKKDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 760 - protein, 2070 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKKDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 761 - protein, 2077 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKKDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 762 - protein, 2079 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 763 - protein, 2110 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 764 - protein, 2073 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 765 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 766 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 767 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 768 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 769 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 770 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 771 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 772 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 773 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 774 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 775 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 776 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 777 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 778 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 779 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 780 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 781 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 782 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 783 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 784 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 785 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 786 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 787 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 788 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 789 - protein, 2073 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGSCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGKVGYCRHFIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQRAGKRTADGSEFEKRTADGSEFESPKKKAKVE

SEQ ID NO: 790 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 791 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 792 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 793 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 794 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 795 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 796 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 797 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 798 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 799 - protein, 2108 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 800 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 801 - protein, 2129 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 802 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 803 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 804 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 805 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 806 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 807 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 808 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 809 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 810 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 811 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 812 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 813 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 814 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 815 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 816 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 817 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 818 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 819 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 820 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 821 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 822 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 823 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 824 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 825 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 826 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 827 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 828 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 829 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 830 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 831 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 832 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 833 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 834 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 835 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 836 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 837 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 838 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 839 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 840 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 841 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 842 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 843 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 844 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 845 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 846 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 847 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 848 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 849 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 850 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 851 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 852 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 853 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 854 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 855 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 856 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 857 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 858 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 859 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 860 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 861 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 862 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 863 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 864 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 865 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 866 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 867 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 868 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 869 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 870 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 871 - protein, 2129 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 872 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 873 - protein, 2108 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 874 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 875 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 876 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 877 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 878 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 879 - protein, 2108 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 880 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 881 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 882 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 883 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 884 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 885 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 886 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 887 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 888 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 889 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 890 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 891 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 892 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 893 - protein, 2113 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 894 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 895 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 896 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 897 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 898 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 899 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 900 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 901 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 902 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 903 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 904 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 905 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 906 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 907 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 908 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 909 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 910 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 911 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 912 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 913 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 914 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 915 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 916 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 917 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 918 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 919 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 920 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 921 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 922 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 923 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 924 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 925 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 926 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 927 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 928 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 929 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 930 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 931 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 932 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 933 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 934 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 935 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 936 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 937 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 938 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 939 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 940 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 941 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 942 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 943 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 944 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 945 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 946 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 947 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 948 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 949 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 950 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 951 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 952 - protein, 2118 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 953 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 954 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 955 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 956 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 957 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 958 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 959 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 960 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 961 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 962 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 963 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 964 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 965 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 966 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 967 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 968 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 969 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 970 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 971 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 972 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 973 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 974 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 975 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 976 - protein, 2115 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 977 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 978 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 979 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 980 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 981 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 982 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 983 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 984 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 985 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 986 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 987 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 988 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 989 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 990 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 991 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 992 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 993 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 994 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 995 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 996 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 997 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 998 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 999 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1000 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1001 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1002 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1003 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1004 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1005 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1006 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1007 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1008 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1009 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1010 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1011 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1012 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1013 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1014 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1015 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1016 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1017 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1018 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1019 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1020 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1021 - protein, 2115 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1022 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1023 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1024 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1025 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1026 - protein, 2110 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1027 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1028 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1029 - protein, 2110 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1030 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1031 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1032 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1033 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1034 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1035 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1036 - protein, 2118 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1037 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1038 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1039 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1040 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1041 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1042 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1043 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1044 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1045 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1046 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1047 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1048 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1049 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1050 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1051 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1052 - protein, 2115 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1053 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1054 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1055 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1056 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1057 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1058 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1059 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1060 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1061 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1062 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1063 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1064 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1065 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1066 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1067 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1068 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1069 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1070 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1071 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1072 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1073 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1074 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1075 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1076 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1077 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1078 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1079 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1080 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1081 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1082 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1083 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1084 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1085 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1086 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1087 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1088 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1089 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1090 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1091 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 1092 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1093 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1094 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1095 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1096 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1097 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1098 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1099 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1100 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1101 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1102 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1103 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1104 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1105 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1106 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1107 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1108 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1109 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1110 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1111 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1112 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1113 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1114 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1115 - protein, 2208 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1116 - protein, 2182 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1117 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1118 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1119 - protein, 2182 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1120 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1121 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1122 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1123 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1124 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1125 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1126 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1127 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1128 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1129 - protein, 2208 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1130 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1131 - protein, 2182 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1132 - protein, 2167 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1133 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 1134 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1135 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1136 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1137 - protein, 2107 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1138 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1139 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1140 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1141 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1142 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1143 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1144 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1145 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1146 - protein, 2133 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1147 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1148 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1149 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1150 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1151 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1152 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1153 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1154 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1155 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1156 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1157 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1158 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1159 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1160 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1161 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1162 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1163 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1164 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1165 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1166 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1167 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1168 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1169 - protein, 2117 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1170 - protein, 2130 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1171 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1172 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1173 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1174 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1175 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1176 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1177 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1178 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1179 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1180 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1181 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1182 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1183 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1184 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1185 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1186 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1187 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1188 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1189 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1190 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1191 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1192 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1193 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1194 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1195 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1196 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1197 - protein, 2130 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1198 - protein, 2104 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1199 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1200 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1201 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1202 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1203 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1204 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1205 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1206 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1207 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1208 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1209 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1210 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1211 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1212 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1213 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1214 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1215 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1216 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1217 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1218 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1219 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1220 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1221 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1222 - protein, 2117 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1223 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1224 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1225 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1226 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1227 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1228 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1229 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1230 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1231 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1232 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1233 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1234 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1235 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1236 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1237 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1238 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1239 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1240 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1241 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1242 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1243 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1244 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1245 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1246 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1247 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1248 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1249 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1250 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1251 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1252 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1253 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1254 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1255 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1256 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1257 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1258 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1259 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1260 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1261 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1262 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1263 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1264 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1265 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1266 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1267 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1268 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1269 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1270 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1271 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1272 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1273 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1274 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1275 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1276 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1277 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1278 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1279 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1280 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1281 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 1282 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1283 - protein, 2190 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1284 - protein, 2183 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1285 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1286 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1287 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1288 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1289 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1290 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1291 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1292 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1293 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1294 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1295 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1296 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1297 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1298 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1299 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1300 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1301 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1302 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1303 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1304 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1305 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1306 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1307 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1308 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1309 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1310 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1311 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1312 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1313 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1314 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1315 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1316 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1317 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1318 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1319 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1320 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1321 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1322 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1323 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1324 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1325 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1326 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1327 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1328 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1329 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1330 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1331 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1332 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1333 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1334 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1335 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1336 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1337 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1338 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1339 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1340 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1341 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1342 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1343 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1344 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1345 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1346 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1347 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1348 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1349 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1350 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1351 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1352 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1353 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1354 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1355 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1356 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1357 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1358 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1359 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1360 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1361 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1362 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1363 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1364 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 1365 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1366 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1367 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1368 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1369 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1370 - protein, 2129 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1371 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1372 - protein, 2133 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1373 - protein, 2117 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1374 - protein, 2107 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1375 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1376 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1377 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1378 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1379 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1380 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1381 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1382 - protein, 2105 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1383 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1384 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1385 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1386 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1387 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1388 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1389 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1390 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1391 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1392 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1393 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1394 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1395 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1396 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1397 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1398 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1399 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1400 - protein, 2112 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1401 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1402 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1403 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1404 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1405 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1406 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1407 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1408 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1409 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1410 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1411 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1412 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1413 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1414 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1415 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1416 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1417 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1418 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1419 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1420 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1421 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1422 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1423 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1424 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1425 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1426 - protein, 2117 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1427 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1428 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1429 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1430 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1431 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1432 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1433 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1434 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1435 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1436 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1437 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1438 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1439 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1440 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1441 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1442 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1443 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1444 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1445 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1446 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1447 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 1448 - protein, 2129 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1449 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1450 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1451 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1452 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1453 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1454 - protein, 2113 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1455 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1456 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1457 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1458 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1459 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1460 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1461 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1462 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1463 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1464 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1465 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1466 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1467 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1468 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1469 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1470 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1471 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1472 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1473 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1474 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1475 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1476 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1477 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 1478 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1479 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1480 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1481 - protein, 2011 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1482 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1483 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1484 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1485 - protein, 2011 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGAVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1486 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGAVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1487 - protein, 2013 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGAVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1488 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1489 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1490 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1491 - protein, 2027 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1492 - protein, 2011 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1493 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1494 - protein, 2011 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1495 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 1496 - protein, 2002 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1497 - protein, 2015 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1498 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1499 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1500 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1501 - protein, 2006 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1502 - protein, 2012 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGGLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1503 - protein, 2015 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGGLEHLPRPPEISQFPLNPERLQALQHLVRKALEAGHIEPYTGPGNNPVFPVKKANGTWRFIHDLRATNSLTVDLSSSSPGPPDLSSPPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPILAGKRTADGSEFEKRTADGSEFESPKKKAKVE

SEQ ID NO: 1504 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1505 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1506 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1507 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1508 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1509 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1510 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGGLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFEQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMALGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1511 - protein, 2001 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1512 - protein, 2004 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGGLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1513 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGGLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1514 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGGLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1515 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGGLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1516 - protein, 2006 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1517 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGGLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPLAGKRTADGSEFEKRTADGSEFESPKKKAKVE

SEQ ID NO: 1518 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFEQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMALGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1519 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1520 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1521 - protein, 2023 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1522 - protein, 2006 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1523 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1524 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1525 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1526 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGGLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1527 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGGLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1528 - protein, 2028 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGGLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1529 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGGLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPLAGKRTADGSEFEKRTADGSEFESPKKKAKVE

SEQ ID NO: 1530 - protein, 2004 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1531 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1532 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1533 - protein, 2031 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1534 - protein, 2006 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1535 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1536 - protein, 2007 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 1537 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGPLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQSAGKRTADGSEFEKRTADGSEFESPKKKAKVE

SEQ ID NO: 1538 - protein, 2001 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGPLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQSAGKRTADGSEFEKRTADGSEFESPKKKAKVE

SEQ ID NO: 1539 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1540 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1541 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1542 - protein, 2137 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1543 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1544 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1545 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1546 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1547 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1548 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1549 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1550 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1551 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1552 - protein, 2111 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1553 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1554 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1555 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1556 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1557 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1558 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1559 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1560 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1561 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1562 - protein, 2111 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1563 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1564 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1565 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1566 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1567 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1568 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1569 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1570 - protein, 2107 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1571 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1572 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1573 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1574 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1575 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1576 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1577 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1578 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1579 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1580 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1581 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1582 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1583 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1584 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1585 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1586 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1587 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1588 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1589 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 1590 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE
